United States Patent 9,222,077 (ANTIBACTERIAL PHAGE, PHAGE PEPTIDES AND METHODS OF USE THEREOF) - sequence listing, part 2

SEQ ID NO: 1268 - protein, 1019 aa, Unknown
  Description of Unknown: Bacteriophage F125/10
VANFLKNLHPLLRRDRNKKDNQDPNFALIDALNEEMNQVEKDAIESKLQSSLKTSTSEYLDKFGDWFGVYRKTDENDDVYRARIIKYLLLKRGTNNAIIDAIKDYLGRDDIDVSVYEPFTNIFYTNKSHLNGEDHLMGYYYRFAVINVSIGDYFPVEIIDVINEFKPAGVTLYVTYDGASTIRGGAIIKWLDGLPKIETYQEFDRFTGYDDTFYGHINMNQSKDTDNSSSDIFKTNHSLINSLDVLTGSSSVGRQYINYGYVTSYVYNPGMTSSVNQISASTEGRGQEVPTDYYMYTSTKNNNTVELSMQTTSGVSYLYNNFNFRDYMSKYRPQVDLQSDEARRIVSDYIKELSIDYYLSAVIPPDESIEIKLQVYDFSINRWLTVSINNLSFYEKNIGSNIGYIKDYLNSELNMFTRLEINAGKRDSVDIKVNYLDLMFYYYERGIYTIKPYKALIENYLDISRETYVEAFKIASLSNGDIITKTGFQPIGYLKLVGNYENTRPSTINIVAKDTDNNPIESNELDVYNTVENRNLLQSYKGANTIAREITSTKEFTVSGWAKEIYSTNYLSKVLKPGKVYTLSFDIEITGNDLTLKSYSDNHGIYLYSNTKGIVVNGVKSMERTIGNKVSVTQTFTAPTITDHRLLIYTGRYTSDGKASTPPVFFNTVKITELKLSEGTSNLEYSPAPEDKPNVIEKGIKFNNILTNIQTLSINSDTILKNVTLYYSYYGDNWVELKTLGNISTGETTETNNLIDLYGLQTVDYSNINPMSKVSLRSIWNVKLGELNNQEGSLSNMPNDYFNAVWQDIDKLSDIEIGSMRMVKDTEGGVFDGATGEIIKATLFNVGSYTDLDMLAYTLTNYTEPLTLGSSRLISELKEELLTSESFNVDNRIKVIDSIYEELPNTSIIKNGFVEREVTGSKYLDYGLYEPIEDGTRYKLIVEGEFKDNIEFIYLYNSNPNFNETFIYPSEIINGVAEKEFIAKPSTEDKPRLNTDVRIYIRPYDSTISKVRRVELRKV

SEQ ID NO: 1269 - protein, 173 aa, Unknown
  Description of Unknown: Bacteriophage F125/10
MAIATYNSHVELAKYLVSKADSVYLTIGKSTPWSNETNPPQPDENATVLQEVIGYKKATKVTLVRPSKSPEDDNKNLISYGNKSWVEVTPENAKAEGAKWVYLESSIVGDELPLGTYRQVGFVMDLVAKSGISKFNLVPSEVESTGTLLFFDNKQFQNRSEQTTAKERFIVEV

SEQ ID NO: 1270 - protein, 1152 aa, Unknown
  Description of Unknown: Bacteriophage F125/10
MAINFKGSPYLDRFDPSKDRTKVLFNPDRPLQQAELNEMQSIDQYYLKNLGDAIFKDGDKQSGLGFTLSEDNVLTVNPGYVYINGKIRYYDNDDSVKITGVGKETIGIKLTERIVTPDEDASLLDQTSGVPSYFSKGADRLEEKMSLTVNDPTSATIYTFMDGDLYIQSTNAEMDKINKVLAERTYDESGSYKVNGFELFSEGNAEDDDHVSVVVDAGKAYVKGFKVDKPVSTRISVPKSYDLGTAENESTIFNKSNNSISLANSPVKEIRRVTGQVLIEKERVTRGAQGDGQDFLSNNTAFEIVKVWTETSPGVTTKEYKQGEDFRLTDGQTIDWSPQGQEPSGGTSYYVSYKYNKRMEAGKDYEVTTQGEGLSKKWYINFTPSNGAKPIDQTVVLVDYTYYLARKDSVFINKYGDIAILPGEPNIMRLVTPPLNTDPENLQLGTVTVLPDSDEAVCISFAITRLSMEDLQKVKTRVDNLEYNQAVNALDDGAMEGQNPLTLRSVFSEGFISLDKADITHPDFGIVFSFEDAEATLAYTEAVNQPKIIPGDTTAHIWGRLISAPFTEERTIYQGQASETLNVNPYNIPNKQGVLKLTPSEDNWIDTENVTITEQKTKKVTMKRFWRHNESYYGETEHYLYSNLQLDAGQKWKGETYAYDREHGRTGTLLESGGQRTLEEMIEFIRIRDVSFEVKGLNPNDNNLYLLFDGVRCAITPATGYRKGSEDGTIMTDAKGTAKGKFTIPAGIRCGNREVTLKNANSTSATTYTAQGRKKTVQDIIIRTRVTVNLVDPLAQSFQYDENRTISSLGLYFASKGDKQSNVVIQIRGMGDQGYPNKTIYAETVMNADDIKVSNNASAETRVYFDDPMMAEGGKEYAIVIITENSDYTMWVGTRTKPKIDKPNEVISGNPYLQGVLFSSSNASTWTPHQNSDLKFGIYTSKFNETATIEFEPIKDVSADRIVLMSTYLTPERTGCTWEMKLILDDMASSTTFDQLKWEPIGNYQDLDVLGLARQVKLRATFESNRYISPLMSSSDLTFTTFLTELTGSYVGRAIDMTEAPYNTVRFSYEAFLPKGTKVVPKYSADDGKTWKTFTKSPTTTRANNEFTRYVIDEKVKSSGTNTKLQVRLDLSTENSFLRPRVRRLMVTTRDE

SEQ ID NO: 1271 - protein, 52 aa, Unknown; identical to SEQ ID NO: 654
  Description of Unknown: Bacteriophage F125/10

SEQ ID NO: 1272 - protein, 640 aa, Unknown
  Description of Unknown: Bacteriophage F125/10
MAFNYTPLTETQKLKDMYPKVNDIGNFLKTEVNLSDVKQISQPDFNNILASIPDSGNYYVTNSKGAPSGEATAGFVRLDKRNVNYYKIYYSPYSSNKMYIKTYANGTVYDWISFKLDEGNLYNEGNTLNVKELTESTTQYATLVNPPKENLNTGWVNYKESKNGVSSLVEFNPVNSTSTFKMIRKLPVQEQKPNLLKDSLFVYPETSYSNIKTDNWDTPPFWGYSSNSGRSGVRFRGENTVQIDDGSNTYPLVVSNRFKMGKELSVGDTVTVSVYAKINDPALLKDNLVYFELAGYDTVDDTSKNPYTGGRREITASEITTEWKKYSFTFTIPENTIGASGVKVNYVSLLLRMNCSSSKGNGAVVYYALPKLEKSPKVTPFITHENDVRKYDEIWSNWQEVISKDELKGHSPVDIEYNDYFKYQWWKSEVNEKSLKDLAMTVPQGYHTFYCQGSIAGTPKGRSIRGTIQVDYDKGDPYRANKFVKLLFTDTEGIPYTLYYGGYNQGWKLLKQSETSTLLWEGTLDFGSTEAVNLNDSLDNYDLIEVTYWTRSAGHFSTKRLDIKNTSNLLYIRDFNISNDSTGSSVDFFEGYCTFPTRASVQPGMVKSITLDGSTNTTKVASWNEKERIKVYNIMGINRG

SEQ ID NO: 1273 - protein, 123 aa, Unknown
  Description of Unknown: Bacteriophage F125/10
MAVKYDIGNNEIVLHLREGKYITGFTTVGGYDKELGQVKVNREILPAYFFDNFAYERYLYYSKPEEVIENKNYVPPQINDDEESQQITVPKEQYDSLKEELELMRKQQEAMMEMLQKLLGQKG

SEQ ID NO: 1274 - protein, 458 aa, Unknown
  Description of Unknown: Bacteriophage F125/10
MALNFTTITENNVIRDLTTQVNNIGEELTKERNIFDITDDLVYNFNKSQKIKLTDDKGLTKSYGNITALRDIKEPGYYYIGARTLATLLDRPDMESLDVVLHVVPLDTSSKVVQHLYTLSTNNNQIKMLYRFVSGNSSSEWQFIQGLPSNKNAVISGTNILDIASPGVYFVMGMTGGMPSGVSSGFLDLSVDANDNRLARLTDAETGKEYTSIKKPTGTYTSWKKEFEPKDMEKYLLSSIRDDGSASFPLLVYTSDNKTFQQAIIDHIDRTGQTTFTFYVQGGVSGSPMSNSCRGLFMSDTPNTSSLHGVYNAIGTDGRNVTGSVVGGNWTSPKTSPSHKELWTGAQSFLSVGTTKNLADDISNYSYVEVYTKHKTVEKTKGNDDSGTICHKFYLDGSGTYVCSGTFVSGDRTDTKPPVTEFYRVGVSFKGSTWTLVDSAVQNSKTQYVTRIIGINMP

SEQ ID NO: 1275 - protein, 582 aa, Unknown
  Description of Unknown: Bacteriophage F125/10
MRLRIKNLYTYVEFEEDDKYLKDIFLKRVHTTIGARQEGFQYSPAYKRGSWDGYVDFYVYEEDKFPTGLLFKIELLLGELQSRYNFQFETIDERDESFLSEEDIDDEITLLDNNVGQITLRDYQYEAVYNSLTFYNGIAHLATNGGKTEVASGIIDQLLPQLEKGERVAFFTGSTEIFHQSADRLQERLNIPIGKVGAGKFDVKQVTVVMIPTLNANLKDPTQGVKVTPKQNISKKIAQEILPKFEGGTNQKKLLKVLLDNTTPKTKVEQNVLSALEIIYQNSKTDAEVLLNLRNHNAHFQKIVREKNEKKYDKYQDMRDFLDSVTVMIVDEAHHSKSDSWYNNLMTCEKALYRIALTGSIDKKDELLWMRLQALFGNVIARTTNKFLIDEGHSARPTINIIPIANPNDIDRIDDYREAYDRGITNNDFRNKLIAKLTEKWYNQDKGTLIIVNFIEHGDTISEMLNDLDVEHYFLHGEIDSETRREKLNDMRSGKLKVMIATSLIDEGVDISGINALILGAGGKSLRQTLQRIGRALRKKKDDNTTQIFDFNDMTNRFLYTHANERRKIYEEEDFEIKDLGK

SEQ ID NO: 1276 - protein, 537 aa, Unknown
  Description of Unknown: Bacteriophage F125/10
MATKTQRKLYQYLEENATENKFHISTKKELADSLGVSISALSNNLKKLEEENKVVTVSKRGKNGGVIITLVREYDTEELKEFNNSTDNIITSDLQYAKALREKHFPSYRYERKEQRRRTKIEMAQYNAIKDEKRRIIADMNFYSEGLPYPSKDIFNMSYDPEGFYKAYILCKLYDQYAISHMDAKHTSHLKAMSKATTKDEYDYHQHMSEYYRNKMIQNLPRNSVSDNFFGSKMFNTFYNFYLKIKDKNINVFKYMQNVFKNVTFYYENGMQPNPIPSPNFFSSDKYFKNYNNYIKGIKKGVNSTNRHLGDTDSIINSSDYVKNPAVLHLHQLYTTGLNSTLHDIDTMFEQALDLENASYGLFGDMKHIILLQYNSMIEEEIKNLPREEKDIINKYVKQCIINDYSPTSISPSARLSMFTMQKEHIVYNKQLNKGIKREDLLPLSLGGIVNKDSLSGMDIQNLEQNGNEYLYMRQHTSTYYILRMFGDYLGYEVNLREVKYIVEKYNLIDKIPLTKEGMLDYNKLIHLVEEEVNNYE

SEQ ID NO: 1277 - protein, 480 aa, Unknown; identical to SEQ ID NO: 660
  Description of Unknown: Bacteriophage F125/10

SEQ ID NO: 1278 - protein, 341 aa, Unknown
  Description of Unknown: Bacteriophage F125/10
MKFVFFTDSHFHLFTNYAKPDNEFVNDRFKEQIEALQKVFDIAKKEEATVIFGGDLFHKRNSVDTRVYNKVFSTFAKNDEVPVLLLRGNHDATTNSLYTDSSIDTFEYLPNVSVIKSLNTILKDNVNIVFTAYGDETKEIKTYINSNYDKDMVNILVGHLGVEGSLTGKGSHRLEGAFGYQDLLPDKYDFILLGHYHRRQYFQNPNHFYGGSLMQQSFSDEQEANGVHLIDTEKMTTEFIPIHTRRFITIQGEDIPENFEQLIEEGNFIRVIGTANHAKVLEMDDSMKDKNVEVQIKKEYTVEKRIDSDVSDDPLTIASTYAKQYSPESEQEILECLKEVL

SEQ ID NO: 1279 - protein, 125 aa, Unknown
  Description of Unknown: Bacteriophage F125/10
MKKYREYLNKTDAENLAEDWEKVTEDLWKVFKDMKPKINTLDISNVESKNLDKSKPILQFQDSDGVIENICNVEGLEDGLSKMKKVFDDSNFEKHYYSRVVDHDEYYWIDYGSHHCFFRVTKGDK

SEQ ID NO: 1280 - protein, 639 aa, Unknown
  Description of Unknown: Bacteriophage F125/10
MVVFKQVEVNNFLAIKEATLELDNRGLILIEGENKSNESFHSNGSGKSTLISAITYALYGKTEKGLKADDVVNNIEKKNTSVKLKFDIGEDSYLIERYRKDKENKNKVKLFVNEKEITGSTNDVTDKQIQDLFGIEFNTYVNAIMYGQGDIPMFSQATDKGKKEILESITKTDVYKQAQDVAKEKVKEVEEQQNNIRQEIYKLGYQLSTKDEYFQREIEQYNQYKEQLVQIENSNKEKDRLREQEEKQIEAQIEQLASQIPTIPEDEFKHSEEYNKASQSLDLLSNKLTELNQVYSEYNTKEQVLKSEIATLSNSLNKLDTNDHCPVCGSPIDNSHKLKEQENINNQIENKKQEITSVLEMKDTYKEAIDKVKDKSQEIKDKMSQEDQQEREHNNKINSIIQEASRIKSDISSLENNKTYLKVKYQHQSVQGLEREEPSKEKHEEDKKELQESIDKHEENIVQLETKKGKYQQAVDAFSNKGIRSVVLDFITPFLNEKANEYLQTLSGSDIEIEFQTQVKNAKGELKDKFDVIVKNSKGGGSYKSNSAGEQKRIDLAISFAIQDLIMSKDEISTNIALYDECFDGLDTIGCENVIKLLKDRLNTVGTIFVITHNTELKPLFEQTIKIVKENGVSKLEEK

SEQ ID NO: 1281 - protein, 198 aa, Unknown; identical to SEQ ID NO: 664
  Description of Unknown: Bacteriophage F125/10

SEQ ID NO: 1282 - protein, 355 aa, Unknown
  Description of Unknown: Bacteriophage F125/10
MRFEDFLTQELGEPKENTIGELRYCCPFCGEKSYKFYVKQALDSSNGQYHCKKCDESGNPITFMKTYYNITGKQAFDLLESKNIDIERAPLLTTNNKDLTESEKLILMLRGVHQDKGTTSIKPPRLPEGYKLLKDNLNNKEIIPFLKYLKGRGITLEQIINNNIGYVINGSFYKVDGESKVSLRNSIIFFTYDNDGNYQYWNTRSIEKNPYIKSINAPAKQDEVGRKDVIFNLNIARKKKFLVITEGVFDALTFHEYGVATLGKQVTENQIKKIIDYVSIDTSIYIMLDTDALDNNIDLAYKLKTHFNKVYFVPHGDEDANDMGTRKAFELLKQNRVLVTPESIQSYKIQQKLKL

SEQ ID NO: 1283 - protein, 112 aa, Unknown
  Description of Unknown: Bacteriophage F125/10
MSNNKKDILEFVDEYITALRVGNEQRQHQLEEMGKEETATLTDVAKAITNLMLGVNEQMTDLEYNNELNLNILIDALYKAELINEDVLDYIQESIDKSQEEPKNEEEKGEQE

SEQ ID NO: 1284 - protein, 150 aa, Unknown; identical to SEQ ID NO: 667
  Description of Unknown: Bacteriophage F125/10

SEQ ID NO: 1285 - protein, 202 aa, Unknown
  Description of Unknown: Bacteriophage F125/10
MTNSKKKGDTFERKIAKELTAWWGYQFNRSPQSGGASWGKDNNAVGDIVVPQEANFPLVVECKHREEWTIDNVLLNNREPHTWWEQVINDSSKVNKTPCLIFTRNRAQSYVALPYNEKVYEDLRNNEYPVMRTDFIIDNIRKDKFFYDVLITTMNGLTSFTPSYIISCYDKKDIKPYKKVESNLSEVSKHEDELINDLLSDI

SEQ ID NO: 1286 - protein, 139 aa, Unknown
  Description of Unknown: Bacteriophage F125/10
VIYKEGKISMTSKERPLIVYFSGTGQTERLVNKININNSFETFRVKSGKEKVNKPFILITPTYKKGAIPKQIERFLEINGSPKEVIGTGNKQWGSNFCGASKKISEMFKIPLIAKVEQSGHFNEIQPILEHFSNKYKVA

SEQ ID NO: 1287 - protein, 704 aa, Unknown
  Description of Unknown: Bacteriophage F125/10
MATYGKWIELNNEITQLDDNGKNKLYKDQEALDEYLKYIEDNTRKFNSEVERIRVLTKEGTYDKIFDKVPDTIIDEMTKLAYSFNFKFPSFMAGQKFYESYASKQYDENKKPIFVEDYEQHNVRVALYLFQNDYVKARELLVQLMEQTFQPSTPTYNNSGQANRGELSSCYLFVVDDSIESLNFVEDSVANASSNGGGVAIDLTRIRPKGAPVRNRPNSSKGVIAFAKAIEHKVSIYDQGGVRQGSGAVYLNIFHNDILDLLSSKKINASESVRLDKLSIGVTIPNKFMELVKEGRPFYTFDTYDINKVYGKYLDELNIDEWYDKLLDNDSIGKVKHDAREVMTDIAKTQLESGYPYVFYIDNANDNHPLKNLGKVKMSNLCTEISQLQEVSEIYPYSYSNKNVINRDVVCTLGSLNLVNVVEKGLLNESVDIGTRALTKVTDIMDLPYLPSVQKANDDIRAIGLGSMNLHGLLAKNMISYGSREALDLVNSLYSAINFQSIKTSMLMAKETGKPFKGFEKSDYATGEYFVRYIRESNQPKTDKAKKVLDKVYIPTQDDWDELAKAVKVHGLYNGYRKAEAPTQSISYVQNATSSIMPVPSAIENRQYGDMETYYPMPYLSPITQFFYEGETAYKIDNKRIINTSAVVQKHTDQAVSTILYVESEIPTNKLVSLYYYAWEQGLKSLYYTRSRKLSVIECETCSV

SEQ ID NO: 1288 - protein, 349 aa, Unknown
  Description of Unknown: Bacteriophage F125/10
MDITQKVKQHNKNAVLKATNWNIEDDGMSDIYWEQGISQFWTPEEFDVSRDLSSWNSLTESEKNTYKKVLAGLTGLDTKQGGEGMNLVSYHEPRPKYQAVFAFMGGMEEIHAKSYSHIFTTLLSNKETSYLLDTWVEENDFLKVKAQFIGYYYDQLLKPNPTVFDRYMAKVASAFLESALFYSGFYYPLLLAGRGQMTQSGAIIYKITQDEAYHGSAVGLTAQYDYNLLTEEEKKQADKETYELLDILYTNEVAYTHSLYDPLELSEDVINYVQYNFNRALQNLGREDYFNPEPYNPIVENQTNVDRLRNVDFFSGKADYEKSTNIKDIKDEDFSFLDSKEYSTAKEFL

SEQ ID NO: 1289 - protein, 109 aa, Unknown
  Description of Unknown: Bacteriophage F125/10
MDRKEAMDLLSKAEILFKKHDEFSCVSDINDPMKLFSNSKDAKADDTSKSFQLEFMHDMTMYTLSYGSGQLKLIDLAEGYEAQKATVVNSFPEIIKTLEKDDSEDGKNE

SEQ ID NO: 1290 - protein, 106 aa, Unknown; identical to SEQ ID NO: 673
  Description of Unknown: Bacteriophage F125/10

SEQ ID NO: 1291 - protein, 198 aa, Unknown; identical to SEQ ID NO: 674
  Description of Unknown: Bacteriophage F125/10

SEQ ID NO: 1292 - protein, 101 aa, Unknown; identical to SEQ ID NO: 675
  Description of Unknown: Bacteriophage F125/10

SEQ ID NO: 1293 - protein, 1072 aa, Unknown
  Description of Unknown: Bacteriophage F125/10
MKVLILFDHIREEHFSVSKDGSVKSNVLNTPNGKTLKKLLEKCSNLKRDKTNRDYDIDFLYNAVPTPIRNDYGKIIKYQDVKQAEVKPYYERMNNIIIDNSYDMIIPVGKLGVKYLLNVTAIGKVRGVPSKVTIENGTSSHDVWVLPTYSIEYTNVNKNSERHVVSDLQTVGKFVEQGEEAFKPKEVSYELVDNIERVREIFNKEVKNDNYDGVDITAWDLETNSLKPDKEGSKPLVLSLSWRNGQGVTIPLYKSDFNWENGQDDIDEVLELLKNWLASKEDIKVAHNGKYDIKFLMSTENFKDFESIQDTKVGWYLAVTQEVKESLRLSDLAYEVTDVGGYDKPLEDFKLWFVTKLLRFFSDKIKEIQKENKKIAKKEYDVKAPEYKEWLENKLNETVVELDDTEKKFRVSELEKKYIQLGLSPEIVNMNLVMNNDEFISIAEQSPEYMGLSDYAKSYTLNTAINLINEYRDVKDVVNDIDGGNFNYDWFPIELMHPYASGDTDVCRRIHCDVVKKLKEQDRPKSMHLLEVNYPRLTKSLARIESNGLYCDLDYMKENDESYESEMAKNHATMREHWAVKEFEEYQYNLYQMALEEHEKKPKDRDKDIHQYRDKFKDGKWMFSPSSGDHKGRVIYDILGIQLPYDKEYVKEKPFNANVKEADLTWQDYKTDKKAIGYALDNLELKDDVRELLELLKYHASMQTKRNSFTKKLPNMINKQKRTLHGSFSETGTETSRLSSSNPNLQNLPAHTSDVNKFDYKHPIKRSFVSRFENGVLLGADYSALEMRIIGLFTKDPDMLQSFLNGEDIHKATASIVYNKPVEEVTKEERQATKAVNFGLAFGESPFSFAGKNNMEVSEAEEIFEKYFQTKPSVKTSIDNVHEFVQQYGYVDTMHGHRRFIRSAQSTDKKIKNEGLRQSFNTIIQGSGSFLTNMSLTYLDDFIQSRNLKSKVIATVHDSILIDCPPEEAKIMAKVTIHIMENLPFDFLKAEIDGKEVQYPIEADMEIGLNYNDMVEYDEEEIDTFNSYQGYIKYMMNLQTLEDYKESGKLTDEQFEKATNVVKSEKHIYQEI

SEQ ID NO: 1294 - protein, 80 aa, Unknown
  Description of Unknown: Bacteriophage F125/10
VNTGEIRFNRSMDEWIITSMYQDELGEMNIVVTFYNREENKHGSTVLPTESSTGEVAEELASLEEEYPLALPLSSISVNI

SEQ ID NO: 1295 - protein, 160 aa, Unknown; identical to SEQ ID NO: 680
  Description of Unknown: Bacteriophage F125/10

SEQ ID NO: 1296 - protein, 423 aa, Unknown; identical to SEQ ID NO: 681
  Description of Unknown: Bacteriophage F125/10

SEQ ID NO: 1297 - protein, 421 aa, Unknown
  Description of Unknown: Bacteriophage F125/10
MARAKKGKEVDLTDLNTIDLGKELGLTLLSDSNRADIKNIVPTMVPQYDRILGGGIPLGRLTEVYGLTGSGKSSFAVHLSRISTQLGVITIWIDIEGTADNNRMEQLGVDVSKLFSIQAGEGRLKNTVELSVETVGKELDYWIDTFNEKAPGVPILFIWDSLGATRTQAEIEEGVDHRKLGTKATATQKVINAVSPKLNDTNTGLIVINQARDNLNMSNPYDDPIKSTGGRAFEHGASLRLKITKGKESDLKQSDSMTGKPTYKGHVMRVETKKSKLSRPGQKAEADLLSGYEVGSGSDITQLNGIDPYHTIYKEAVERGLITKGTWRNYITLNGEEIKLYDKDWVPRLIDDHELYLELFSRVYGEHFPNGYSPLLNTKVIVTQLEEYQALENYYEEWAKDNKQEEQEEESKGESQEKDSE

SEQ ID NO: 1298 - protein, 117 aa, Unknown
  Description of Unknown: Bacteriophage F125/10
MYNLIDKNMRQVKESLGNANSSDVLPLPYKDIAKKFEEVKEKGESIIIEEGGFPYTDSTVMYIEHVTDRWAGGYSLIRHEGEEVKVPKTIHFSDIYVKDKSHKVRIIFEGANPYEEG

SEQ ID NO: 1299 - protein, 220 aa, Unknown
  Description of Unknown: Bacteriophage F125/10
MKKAKNGNRYVIDIDGIPVDFERDLDSLLNRYKNLRWSLYHKYAGILSNDFERQELREYIDEQFIKLVKEYNIRSKVDFPGYIKAKLTLRVQNSYVKKNEKYKRTEIIGKKDYTVESLTEDLNEDFEDNQIMSYVFDDIEFTEVQSELLKELLINPEREDDAFIVSQVAEKFDMKRKEVASELTELRDYVRFKINAYHEYYAKKELNNHRVNTENHIWEN

SEQ ID NO: 1300 - protein, 293 aa, Unknown
  Description of Unknown: Bacteriophage F125/10
VRIEKHKIKNNKVINEMSITANNLYNHANFILRQNFFNNKTNKGYRKFLNYNTIHRILKNMNEENYIKLPRQTSQQVLRDLINNWSSFRKSEKDYFKNPNKYRNRPKPPKYKAKGGKGTIKFTNQQCRIHKKDGLIHLPTPLQDITIKPYKAKNIRELVCIPKSDYFEVLVCYKEENSNKTLNDNENIASIDLGLDNLITMVSIVDKPIIINGKGLKSKNKYFNKKIRYYQSLLQNNSYSSKRILKYWEKRHNIILDYFHKATNEVVKYCVKNDISKVVIGYNKQQKYKSKLK
